United States Patent 12,297,469 (METHODS AND COMPOSITIONS FOR INHIBITING ADAM10 BIOLOGICAL ACTIVITIES) - sequence listing, part 4

SEQ ID NO: 24350 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 24351 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 24352 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 24353 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 24354 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 24355 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 24356 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 24357 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 24358 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 24359 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 24360 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 24361 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 24362 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 24363 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 24364 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 24365 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 24366 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 24367 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 24368 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 24369 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 24370 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 24371 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 24372 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 24373 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 24374 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 24375 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 24376 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 24377 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 24378 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 24379 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 24380 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 24381 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 24382 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 24383 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 24384 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 24385 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 24386 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 24387 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 24388 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 24389 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 24390 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 24391 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 24392 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 24393 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 24394 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 24395 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 24396 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 24397 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 24398 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 24399 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 24400 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 24401 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 24402 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 24403 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 24404 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 24405 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 24406 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 24407 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 24408 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 24409 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 24410 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 24411 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 24412 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 24413 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 24414 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 24415 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 24416 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 24417 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 24418 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 24419 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 24420 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 24421 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 24422 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 24423 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 24424 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 24425 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 24426 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 24427 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 24428 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 24429 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 24430 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 24431 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 24432 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 24433 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 24434 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 24435 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 24436 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 24437 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 24438 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 24439 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 24440 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 24441 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 24442 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 24443 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 24444 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 24445 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 24446 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 24447 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 24448 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 24449 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 24450 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 24451 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 24452 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 24453 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 24454 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 24455 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 24456 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 24457 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 24458 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 24459 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 24460 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 24461 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 24462 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 24463 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 24464 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 24465 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 24466 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 24467 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 24468 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 24469 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 24470 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 24471 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 24472 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 24473 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 24474 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 24475 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 24476 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 24477 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 24478 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 24479 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 24480 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 24481 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 24482 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 24483 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 24484 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 24485 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 24486 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 24487 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 24488 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 24489 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 24490 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 24491 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 24492 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 24493 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 24494 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 24495 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 24496 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 24497 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 24498 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 24499 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 24500 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 24501 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 24502 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 24503 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 24504 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 24505 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 24506 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 24507 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 24508 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 24509 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 24510 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 24511 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 24512 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 24513 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 24514 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 24515 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 24516 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 24517 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 24518 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 24519 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 24520 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 24521 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 24522 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 24523 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 24524 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 24525 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 24526 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 24527 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 24528 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 24529 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 24530 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 24531 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 24532 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 24533 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 24534 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 24535 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 24536 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 24537 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 24538 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 24539 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 24540 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 24541 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 24542 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 24543 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 24544 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 24545 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 24546 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 24547 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 24548 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 24549 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 24550 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 24551 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 24552 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 24553 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 24554 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 24555 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 24556 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 24557 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 24558 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 24559 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 24560 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 24561 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 24562 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 24563 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 24564 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 24565 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 24566 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 24567 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 24568 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 24569 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 24570 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 24571 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 24572 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 24573 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 24574 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 24575 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 24576 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 24577 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 24578 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 24579 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 24580 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 24581 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 24582 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 24583 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 24584 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 24585 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 24586 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 24587 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 24588 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 24589 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 24590 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 24591 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 24592 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 24593 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 24594 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 24595 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 24596 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 24597 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 24598 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 24599 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 24600 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 24601 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 24602 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 24603 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 24604 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 24605 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 24606 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 24607 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 24608 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 24609 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 24610 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 24611 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 24612 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 24613 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 24614 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 24615 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 24616 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 24617 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 24618 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 24619 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 24620 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 24621 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 24622 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 24623 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 24624 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 24625 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 24626 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 24627 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 24628 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 24629 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 24630 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 24631 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 24632 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 24633 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 24634 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 24635 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 24636 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 24637 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 24638 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 24639 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 24640 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 24641 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 24642 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 24643 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 24644 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 24645 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 24646 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 24647 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 24648 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 24649 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 24650 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 24651 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 24652 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 24653 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 24654 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 24655 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 24656 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 24657 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 24658 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 24659 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 24660 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 24661 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 24662 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 24663 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 24664 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 24665 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 24666 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 24667 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 24668 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 24669 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 24670 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 24671 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 24672 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 24673 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 24674 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 24675 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 24676 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 24677 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 24678 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 24679 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 24680 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 24681 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 24682 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 24683 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 24684 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 24685 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 24686 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 24687 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 24688 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 24689 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 24690 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 24691 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 24692 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 24693 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 24694 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 24695 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 24696 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 24697 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 24698 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 24699 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 24700 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 24701 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 24702 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 24703 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 24704 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 24705 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 24706 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 24707 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 24708 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 24709 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 24710 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 24711 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 24712 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 24713 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 24714 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 24715 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 24716 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 24717 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 24718 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 24719 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 24720 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 24721 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 24722 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 24723 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 24724 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 24725 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 24726 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 24727 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 24728 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 24729 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 24730 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 24731 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 24732 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 24733 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 24734 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 24735 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 24736 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 24737 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 24738 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 24739 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 24740 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 24741 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 24742 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 24743 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 24744 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 24745 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 24746 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 24747 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 24748 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 24749 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 24750 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 24751 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 24752 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 24753 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 24754 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 24755 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 24756 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 24757 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 24758 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 24759 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 24760 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 24761 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 24762 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 24763 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 24764 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 24765 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 24766 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 24767 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 24768 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 24769 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 24770 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 24771 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 24772 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 24773 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 24774 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 24775 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 24776 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 24777 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 24778 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 24779 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 24780 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 24781 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 24782 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 24783 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 24784 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 24785 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 24786 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 24787 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 24788 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 24789 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 24790 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 24791 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 24792 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 24793 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 24794 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 24795 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 24796 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 24797 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 24798 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 24799 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 24800 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 24801 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 24802 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 24803 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 24804 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 24805 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 24806 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 24807 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 24808 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 24809 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 24810 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 24811 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 24812 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 24813 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 24814 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 24815 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 24816 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 24817 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 24818 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 24819 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 24820 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 24821 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 24822 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 24823 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 24824 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 24825 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 24826 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 24827 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 24828 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 24829 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 24830 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 24831 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 24832 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 24833 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 24834 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 24835 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 24836 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 24837 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 24838 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 24839 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 24840 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 24841 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 24842 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 24843 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 24844 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 24845 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 24846 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 24847 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 24848 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 24849 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 24850 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 24851 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 24852 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 24853 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 24854 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 24855 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 24856 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 24857 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 24858 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 24859 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 24860 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 24861 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 24862 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 24863 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 24864 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 24865 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 24866 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 24867 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 24868 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 24869 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 24870 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 24871 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 24872 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 24873 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 24874 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 24875 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 24876 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 24877 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 24878 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 24879 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 24880 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 24881 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 24882 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 24883 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 24884 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 24885 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 24886 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 24887 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 24888 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 24889 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 24890 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 24891 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 24892 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 24893 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 24894 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 24895 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 24896 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 24897 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 24898 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 24899 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 24900 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 24901 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 24902 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 24903 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 24904 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 24905 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 24906 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 24907 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 24908 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 24909 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 24910 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 24911 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 24912 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 24913 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 24914 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 24915 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 24916 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 24917 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 24918 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 24919 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 24920 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 24921 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 24922 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 24923 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 24924 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 24925 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 24926 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 24927 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 24928 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 24929 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 24930 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 24931 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 24932 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 24933 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 24934 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 24935 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 24936 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 24937 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 24938 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 24939 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 24940 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 24941 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 24942 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 24943 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 24944 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 24945 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 24946 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 24947 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 24948 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 24949 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 24950 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 24951 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 24952 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 24953 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 24954 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 24955 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 24956 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 24957 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 24958 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 24959 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 24960 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 24961 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 24962 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 24963 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 24964 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 24965 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 24966 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 24967 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 24968 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 24969 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 24970 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 24971 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 24972 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 24973 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 24974 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 24975 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 24976 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 24977 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 24978 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 24979 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 24980 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 24981 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 24982 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 24983 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 24984 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 24985 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 24986 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 24987 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 24988 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 24989 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 24990 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 24991 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 24992 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 24993 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 24994 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 24995 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 24996 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 24997 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 24998 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 24999 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 25000 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 25001 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 25002 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 25003 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 25004 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 25005 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 25006 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 25007 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 25008 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 25009 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 25010 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 25011 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 25012 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 25013 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 25014 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 25015 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 25016 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 25017 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 25018 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 25019 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 25020 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 25021 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 25022 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 25023 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 25024 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 25025 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 25026 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 25027 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 25028 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 25029 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 25030 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 25031 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 25032 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 25033 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 25034 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 25035 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 25036 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 25037 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 25038 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 25039 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 25040 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 25041 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 25042 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 25043 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 25044 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 25045 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 25046 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 25047 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 25048 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 25049 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 25050 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 25051 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 25052 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 25053 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 25054 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 25055 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 25056 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 25057 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 25058 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 25059 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 25060 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 25061 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 25062 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 25063 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 25064 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 25065 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 25066 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 25067 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 25068 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 25069 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 25070 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 25071 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 25072 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 25073 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 25074 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 25075 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 25076 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 25077 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 25078 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 25079 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 25080 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 25081 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 25082 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 25083 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 25084 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 25085 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 25086 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 25087 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 25088 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 25089 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 25090 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 25091 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 25092 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 25093 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 25094 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 25095 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 25096 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 25097 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 25098 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 25099 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 25100 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 25101 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 25102 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 25103 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 25104 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 25105 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 25106 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 25107 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 25108 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 25109 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 25110 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 25111 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 25112 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 25113 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 25114 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 25115 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 25116 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 25117 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 25118 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 25119 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 25120 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 25121 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 25122 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 25123 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 25124 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 25125 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 25126 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 25127 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 25128 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 25129 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 25130 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 25131 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 25132 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 25133 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 25134 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 25135 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 25136 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 25137 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 25138 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 25139 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 25140 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 25141 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 25142 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 25143 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 25144 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 25145 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 25146 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 25147 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 25148 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 25149 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 25150 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 25151 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 25152 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 25153 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 25154 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 25155 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 25156 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 25157 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 25158 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 25159 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 25160 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 25161 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 25162 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 25163 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 25164 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 25165 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 25166 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 25167 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 25168 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 25169 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 25170 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 25171 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 25172 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 25173 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 25174 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 25175 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 25176 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 25177 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 25178 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 25179 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 25180 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 25181 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 25182 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 25183 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 25184 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 25185 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 25186 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 25187 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 25188 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 25189 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 25190 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 25191 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 25192 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 25193 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 25194 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 25195 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 25196 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 25197 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 25198 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 25199 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 25200 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 25201 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 25202 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 25203 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 25204 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 25205 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 25206 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 25207 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 25208 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 25209 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 25210 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 25211 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 25212 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 25213 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 25214 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 25215 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 25216 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 25217 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 25218 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 25219 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 25220 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 25221 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 25222 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 25223 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 25224 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 25225 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 25226 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 25227 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 25228 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 25229 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 25230 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 25231 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 25232 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 25233 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 25234 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 25235 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 25236 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 25237 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 25238 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 25239 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 25240 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 25241 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 25242 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 25243 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 25244 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 25245 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 25246 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 25247 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 25248 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 25249 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 25250 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 25251 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 25252 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 25253 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 25254 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 25255 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 25256 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 25257 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 25258 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 25259 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 25260 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 25261 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 25262 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 25263 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 25264 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 25265 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 25266 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 25267 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 25268 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 25269 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 25270 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 25271 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 25272 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 25273 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 25274 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 25275 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 25276 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 25277 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 25278 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 25279 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 25280 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 25281 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 25282 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 25283 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 25284 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 25285 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 25286 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 25287 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 25288 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 25289 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 25290 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 25291 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 25292 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 25293 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 25294 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 25295 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 25296 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 25297 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 25298 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 25299 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 25300 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 25301 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 25302 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 25303 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 25304 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 25305 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 25306 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 25307 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 25308 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 25309 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 25310 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 25311 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 25312 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 25313 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 25314 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 25315 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 25316 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 25317 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 25318 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 25319 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 25320 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 25321 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 25322 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 25323 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 25324 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 25325 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 25326 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 25327 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 25328 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 25329 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 25330 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 25331 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 25332 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 25333 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 25334 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 25335 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 25336 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 25337 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 25338 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 25339 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 25340 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 25341 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 25342 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 25343 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 25344 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 25345 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 25346 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 25347 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 25348 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 25349 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 25350 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 25351 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 25352 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 25353 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 25354 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 25355 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 25356 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 25357 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 25358 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 25359 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 25360 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 25361 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 25362 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 25363 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 25364 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 25365 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 25366 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 25367 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 25368 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 25369 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 25370 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 25371 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 25372 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 25373 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 25374 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 25375 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 25376 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 25377 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 25378 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 25379 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 25380 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 25381 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 25382 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 25383 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 25384 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 25385 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 25386 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 25387 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 25388 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 25389 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 25390 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 25391 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 25392 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 25393 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 25394 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 25395 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 25396 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 25397 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 25398 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 25399 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 25400 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 25401 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 25402 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 25403 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 25404 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 25405 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 25406 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 25407 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 25408 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 25409 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 25410 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 25411 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 25412 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 25413 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 25414 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 25415 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 25416 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 25417 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 25418 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 25419 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 25420 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 25421 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 25422 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 25423 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 25424 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 25425 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 25426 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 25427 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 25428 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 25429 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 25430 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 25431 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 25432 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 25433 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 25434 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 25435 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 25436 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 25437 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 25438 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 25439 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 25440 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 25441 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 25442 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 25443 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 25444 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 25445 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 25446 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 25447 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 25448 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 25449 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 25450 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 25451 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 25452 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 25453 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 25454 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 25455 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 25456 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 25457 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 25458 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 25459 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 25460 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 25461 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 25462 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 25463 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 25464 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 25465 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 25466 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 25467 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 25468 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 25469 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 25470 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 25471 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 25472 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 25473 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 25474 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 25475 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 25476 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 25477 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 25478 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 25479 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 25480 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 25481 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 25482 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 25483 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 25484 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 25485 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 25486 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 25487 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 25488 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 25489 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 25490 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 25491 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 25492 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 25493 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 25494 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 25495 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 25496 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 25497 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 25498 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 25499 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 25500 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 25501 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 25502 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 25503 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 25504 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 25505 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 25506 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 25507 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 25508 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 25509 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 25510 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 25511 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 25512 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 25513 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 25514 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 25515 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 25516 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 25517 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 25518 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 25519 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 25520 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 25521 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 25522 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 25523 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 25524 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 25525 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 25526 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 25527 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 25528 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 25529 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 25530 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 25531 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 25532 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 25533 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 25534 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 25535 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 25536 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 25537 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 25538 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 25539 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 25540 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 25541 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 25542 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 25543 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 25544 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 25545 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 25546 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 25547 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 25548 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 25549 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 25550 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 25551 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 25552 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 25553 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 25554 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 25555 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 25556 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 25557 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 25558 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 25559 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 25560 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 25561 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 25562 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 25563 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 25564 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 25565 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 25566 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 25567 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 25568 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 25569 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 25570 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 25571 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 25572 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 25573 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 25574 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 25575 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 25576 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 25577 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 25578 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 25579 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 25580 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 25581 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 25582 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 25583 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 25584 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 25585 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 25586 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 25587 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 25588 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 25589 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 25590 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 25591 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 25592 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 25593 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 25594 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 25595 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 25596 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 25597 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 25598 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 25599 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 25600 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 25601 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 25602 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 25603 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 25604 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 25605 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 25606 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 25607 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 25608 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 25609 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 25610 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 25611 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 25612 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 25613 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 25614 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 25615 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 25616 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 25617 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 25618 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 25619 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 25620 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 25621 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 25622 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 25623 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 25624 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 25625 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 25626 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 25627 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 25628 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 25629 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 25630 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 25631 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 25632 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 25633 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 25634 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 25635 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 25636 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 25637 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 25638 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 25639 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 25640 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 25641 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 25642 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 25643 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 25644 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 25645 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 25646 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 25647 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 25648 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 25649 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 25650 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 25651 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 25652 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 25653 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 25654 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 25655 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 25656 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 25657 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 25658 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 25659 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 25660 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 25661 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 25662 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 25663 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 25664 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 25665 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 25666 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 25667 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 25668 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 25669 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 25670 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 25671 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 25672 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 25673 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 25674 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 25675 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 25676 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 25677 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 25678 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 25679 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 25680 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 25681 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 25682 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 25683 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 25684 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 25685 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 25686 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 25687 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 25688 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 25689 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 25690 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 25691 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 25692 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 25693 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 25694 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 25695 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 25696 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 25697 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 25698 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 25699 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 25700 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 25701 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 25702 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 25703 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 25704 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 25705 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 25706 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 25707 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 25708 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 25709 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 25710 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 25711 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 25712 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 25713 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 25714 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 25715 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 25716 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 25717 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 25718 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 25719 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 25720 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 25721 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 25722 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 25723 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 25724 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 25725 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 25726 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 25727 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 25728 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 25729 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 25730 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 25731 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 25732 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 25733 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 25734 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 25735 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 25736 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 25737 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 25738 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 25739 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 25740 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 25741 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 25742 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 25743 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 25744 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 25745 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 25746 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 25747 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 25748 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 25749 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 25750 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 25751 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 25752 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 25753 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 25754 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 25755 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 25756 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 25757 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 25758 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 25759 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 25760 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 25761 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 25762 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 25763 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 25764 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 25765 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 25766 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 25767 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 25768 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 25769 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 25770 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 25771 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 25772 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 25773 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 25774 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 25775 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 25776 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 25777 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 25778 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 25779 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 25780 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 25781 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 25782 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 25783 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 25784 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 25785 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 25786 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 25787 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 25788 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 25789 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 25790 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 25791 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 25792 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 25793 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 25794 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 25795 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 25796 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 25797 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 25798 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 25799 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 25800 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 25801 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 25802 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 25803 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 25804 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 25805 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 25806 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 25807 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 25808 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 25809 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 25810 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 25811 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 25812 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 25813 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 25814 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 25815 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 25816 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 25817 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 25818 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 25819 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 25820 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 25821 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 25822 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 25823 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 25824 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 25825 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 25826 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 25827 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 25828 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 25829 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 25830 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 25831 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 25832 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 25833 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 25834 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 25835 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 25836 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 25837 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 25838 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 25839 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 25840 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 25841 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 25842 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 25843 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 25844 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 25845 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 25846 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 25847 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 25848 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 25849 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 25850 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 25851 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 25852 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 25853 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 25854 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 25855 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 25856 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 25857 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 25858 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 25859 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 25860 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 25861 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 25862 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 25863 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 25864 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 25865 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 25866 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 25867 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 25868 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 25869 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 25870 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 25871 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 25872 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 25873 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 25874 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 25875 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 25876 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 25877 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 25878 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 25879 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 25880 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 25881 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 25882 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 25883 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 25884 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 25885 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 25886 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 25887 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 25888 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 25889 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 25890 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 25891 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 25892 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 25893 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 25894 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 25895 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 25896 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 25897 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 25898 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 25899 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 25900 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 25901 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 25902 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 25903 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 25904 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 25905 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 25906 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 25907 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 25908 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 25909 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 25910 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 25911 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 25912 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 25913 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 25914 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 25915 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 25916 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 25917 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 25918 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 25919 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 25920 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 25921 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 25922 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 25923 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 25924 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 25925 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 25926 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 25927 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 25928 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 25929 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 25930 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 25931 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 25932 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 25933 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 25934 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 25935 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 25936 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 25937 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 25938 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 25939 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 25940 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 25941 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 25942 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 25943 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 25944 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 25945 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 25946 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 25947 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 25948 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 25949 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 25950 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 25951 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 25952 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 25953 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 25954 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 25955 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 25956 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 25957 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 25958 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 25959 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 25960 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 25961 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 25962 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 25963 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 25964 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 25965 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 25966 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 25967 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 25968 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 25969 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 25970 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 25971 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 25972 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 25973 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 25974 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 25975 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 25976 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 25977 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 25978 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 25979 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 25980 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 25981 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 25982 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 25983 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 25984 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 25985 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 25986 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 25987 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 25988 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 25989 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 25990 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 25991 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 25992 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 25993 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 25994 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 25995 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 25996 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 25997 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 25998 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 25999 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 26000 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 26001 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 26002 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 26003 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 26004 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 26005 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 26006 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 26007 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 26008 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 26009 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 26010 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 26011 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 26012 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 26013 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 26014 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 26015 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 26016 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 26017 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 26018 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 26019 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 26020 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 26021 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 26022 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 26023 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 26024 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 26025 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 26026 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 26027 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 26028 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 26029 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 26030 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 26031 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 26032 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 26033 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 26034 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 26035 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 26036 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 26037 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 26038 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 26039 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 26040 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 26041 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 26042 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 26043 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 26044 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 26045 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 26046 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 26047 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 26048 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 26049 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 26050 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 26051 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 26052 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 26053 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 26054 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 26055 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 26056 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 26057 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 26058 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 26059 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 26060 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 26061 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 26062 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 26063 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 26064 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 26065 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 26066 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 26067 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 26068 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 26069 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 26070 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 26071 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 26072 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 26073 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 26074 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 26075 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 26076 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 26077 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 26078 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 26079 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 26080 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 26081 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 26082 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 26083 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 26084 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 26085 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 26086 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 26087 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 26088 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 26089 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 26090 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 26091 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 26092 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 26093 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 26094 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 26095 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 26096 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 26097 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 26098 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 26099 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 26100 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 26101 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 26102 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 26103 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 26104 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 26105 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 26106 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 26107 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 26108 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 26109 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 26110 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 26111 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 26112 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 26113 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 26114 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 26115 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 26116 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 26117 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 26118 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 26119 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 26120 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 26121 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 26122 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 26123 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 26124 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 26125 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 26126 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 26127 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 26128 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 26129 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 26130 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 26131 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 26132 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 26133 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 26134 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 26135 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 26136 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 26137 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 26138 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 26139 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 26140 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 26141 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 26142 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 26143 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 26144 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 26145 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 26146 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 26147 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 26148 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 26149 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 26150 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 26151 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 26152 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 26153 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 26154 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 26155 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 26156 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 26157 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 26158 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 26159 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 26160 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 26161 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 26162 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 26163 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 26164 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 26165 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 26166 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 26167 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 26168 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 26169 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 26170 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 26171 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 26172 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 26173 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 26174 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 26175 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 26176 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 26177 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 26178 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 26179 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 26180 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 26181 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 26182 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 26183 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 26184 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 26185 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 26186 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 26187 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 26188 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 26189 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 26190 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 26191 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 26192 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 26193 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 26194 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 26195 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 26196 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 26197 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 26198 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 26199 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 26200 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 26201 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 26202 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 26203 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 26204 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 26205 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 26206 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 26207 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 26208 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 26209 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 26210 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 26211 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 26212 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 26213 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 26214 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 26215 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 26216 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 26217 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 26218 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 26219 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 26220 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 26221 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 26222 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 26223 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 26224 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 26225 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 26226 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 26227 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 26228 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 26229 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 26230 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 26231 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 26232 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 26233 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 26234 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 26235 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 26236 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 26237 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 26238 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 26239 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 26240 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 26241 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 26242 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 26243 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 26244 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 26245 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 26246 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 26247 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 26248 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 26249 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 26250 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 26251 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 26252 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 26253 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 26254 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 26255 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 26256 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 26257 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 26258 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 26259 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 26260 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 26261 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 26262 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 26263 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 26264 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 26265 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 26266 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 26267 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 26268 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 26269 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 26270 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 26271 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 26272 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 26273 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 26274 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 26275 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 26276 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 26277 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 26278 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 26279 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 26280 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 26281 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 26282 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 26283 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 26284 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 26285 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 26286 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 26287 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 26288 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 26289 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 26290 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 26291 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 26292 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 26293 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 26294 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 26295 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 26296 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 26297 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 26298 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 26299 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 26300 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 26301 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 26302 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 26303 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 26304 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 26305 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 26306 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 26307 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 26308 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 26309 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 26310 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 26311 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 26312 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 26313 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 26314 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 26315 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 26316 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 26317 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 26318 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 26319 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 26320 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 26321 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 26322 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 26323 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 26324 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 26325 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 26326 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 26327 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 26328 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 26329 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 26330 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 26331 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 26332 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 26333 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 26334 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 26335 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 26336 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 26337 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 26338 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 26339 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 26340 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 26341 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 26342 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 26343 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 26344 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 26345 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 26346 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 26347 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 26348 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 26349 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 26350 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 26351 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 26352 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 26353 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 26354 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 26355 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 26356 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 26357 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 26358 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 26359 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 26360 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 26361 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 26362 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 26363 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 26364 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 26365 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 26366 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 26367 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 26368 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 26369 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 26370 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 26371 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 26372 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 26373 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 26374 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 26375 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 26376 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 26377 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 26378 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 26379 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 26380 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 26381 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 26382 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 26383 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 26384 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 26385 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 26386 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 26387 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 26388 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 26389 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 26390 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 26391 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 26392 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 26393 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 26394 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 26395 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 26396 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 26397 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 26398 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 26399 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 26400 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 26401 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 26402 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 26403 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 26404 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 26405 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 26406 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 26407 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 26408 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 26409 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 26410 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 26411 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 26412 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 26413 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 26414 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 26415 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 26416 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 26417 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 26418 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 26419 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 26420 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 26421 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 26422 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 26423 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 26424 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 26425 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 26426 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 26427 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 26428 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 26429 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 26430 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 26431 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 26432 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 26433 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 26434 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 26435 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 26436 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 26437 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 26438 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 26439 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 26440 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 26441 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 26442 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 26443 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 26444 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 26445 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 26446 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 26447 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 26448 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 26449 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 26450 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 26451 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 26452 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 26453 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 26454 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 26455 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 26456 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 26457 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 26458 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 26459 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 26460 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 26461 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 26462 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 26463 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 26464 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 26465 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 26466 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 26467 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 26468 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 26469 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 26470 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 26471 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 26472 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 26473 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 26474 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 26475 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 26476 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 26477 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 26478 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 26479 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 26480 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 26481 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 26482 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 26483 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 26484 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 26485 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 26486 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 26487 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 26488 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 26489 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 26490 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 26491 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 26492 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 26493 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 26494 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 26495 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 26496 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 26497 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 26498 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 26499 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 26500 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 26501 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 26502 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 26503 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 26504 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 26505 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 26506 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 26507 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 26508 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 26509 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 26510 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 26511 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 26512 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 26513 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 26514 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 26515 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 26516 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 26517 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 26518 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 26519 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 26520 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 26521 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 26522 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 26523 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 26524 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 26525 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 26526 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 26527 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 26528 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 26529 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 26530 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 26531 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 26532 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 26533 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 26534 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 26535 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 26536 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 26537 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 26538 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 26539 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 26540 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 26541 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 26542 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 26543 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 26544 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 26545 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 26546 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 26547 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 26548 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 26549 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 26550 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 26551 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 26552 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 26553 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 26554 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 26555 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 26556 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 26557 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 26558 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 26559 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 26560 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 26561 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 26562 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 26563 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 26564 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 26565 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 26566 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 26567 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 26568 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 26569 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 26570 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 26571 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 26572 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 26573 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 26574 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 26575 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 26576 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 26577 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 26578 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 26579 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 26580 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 26581 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 26582 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 26583 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 26584 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 26585 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 26586 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 26587 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 26588 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 26589 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 26590 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 26591 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 26592 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 26593 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 26594 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 26595 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 26596 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 26597 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 26598 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 26599 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 26600 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 26601 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 26602 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 26603 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 26604 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 26605 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 26606 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 26607 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 26608 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 26609 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 26610 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 26611 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 26612 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 26613 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 26614 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 26615 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 26616 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 26617 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 26618 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 26619 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 26620 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 26621 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 26622 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 26623 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 26624 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 26625 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 26626 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 26627 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 26628 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 26629 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 26630 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 26631 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 26632 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 26633 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 26634 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 26635 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 26636 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 26637 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 26638 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 26639 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 26640 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 26641 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 26642 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 26643 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 26644 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 26645 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 26646 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 26647 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 26648 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 26649 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 26650 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 26651 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 26652 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 26653 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 26654 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 26655 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 26656 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 26657 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 26658 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 26659 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 26660 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 26661 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 26662 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 26663 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 26664 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 26665 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 26666 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 26667 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 26668 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 26669 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 26670 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 26671 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 26672 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 26673 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 26674 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 26675 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 26676 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 26677 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 26678 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 26679 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 26680 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 26681 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 26682 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 26683 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 26684 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 26685 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 26686 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 26687 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 26688 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 26689 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 26690 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 26691 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 26692 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 26693 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 26694 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 26695 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 26696 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 26697 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 26698 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 26699 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 26700 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 26701 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 26702 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 26703 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 26704 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 26705 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 26706 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 26707 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 26708 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 26709 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 26710 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 26711 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 26712 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 26713 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 26714 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 26715 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 26716 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 26717 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 26718 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 26719 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 26720 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 26721 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 26722 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 26723 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 26724 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 26725 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 26726 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 26727 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 26728 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 26729 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 26730 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 26731 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 26732 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 26733 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 26734 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 26735 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 26736 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 26737 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 26738 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 26739 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 26740 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 26741 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 26742 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 26743 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 26744 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 26745 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 26746 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 26747 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 26748 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 26749 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 26750 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 26751 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 26752 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 26753 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 26754 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 26755 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 26756 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 26757 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 26758 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 26759 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 26760 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 26761 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 26762 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 26763 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 26764 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 26765 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 26766 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 26767 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 26768 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 26769 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 26770 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 26771 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 26772 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 26773 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 26774 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 26775 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 26776 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 26777 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 26778 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 26779 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 26780 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 26781 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 26782 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 26783 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 26784 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 26785 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 26786 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 26787 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 26788 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 26789 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 26790 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 26791 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 26792 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 26793 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 26794 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 26795 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 26796 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 26797 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 26798 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 26799 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 26800 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 26801 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 26802 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 26803 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 26804 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 26805 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 26806 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 26807 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 26808 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 26809 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 26810 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 26811 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 26812 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 26813 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 26814 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 26815 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 26816 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 26817 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 26818 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 26819 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 26820 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 26821 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 26822 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 26823 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 26824 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 26825 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 26826 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 26827 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 26828 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 26829 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 26830 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 26831 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 26832 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 26833 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 26834 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 26835 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 26836 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 26837 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 26838 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 26839 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 26840 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 26841 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 26842 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 26843 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 26844 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 26845 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 26846 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 26847 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 26848 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 26849 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 26850 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 26851 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 26852 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 26853 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 26854 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 26855 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 26856 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 26857 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 26858 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 26859 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 26860 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 26861 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 26862 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 26863 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 26864 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 26865 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 26866 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 26867 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 26868 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 26869 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 26870 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 26871 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 26872 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 26873 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 26874 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 26875 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 26876 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 26877 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 26878 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 26879 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 26880 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 26881 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 26882 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 26883 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 26884 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 26885 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 26886 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 26887 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 26888 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 26889 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 26890 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 26891 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 26892 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 26893 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 26894 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 26895 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 26896 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 26897 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 26898 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 26899 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 26900 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 26901 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 26902 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 26903 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 26904 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 26905 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 26906 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 26907 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 26908 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 26909 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 26910 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 26911 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 26912 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 26913 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 26914 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 26915 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 26916 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 26917 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 26918 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 26919 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 26920 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 26921 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 26922 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 26923 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 26924 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 26925 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 26926 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 26927 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 26928 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 26929 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 26930 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 26931 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 26932 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 26933 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 26934 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 26935 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 26936 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 26937 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 26938 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 26939 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 26940 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 26941 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 26942 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 26943 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 26944 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 26945 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 26946 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 26947 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 26948 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 26949 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 26950 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 26951 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 26952 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 26953 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 26954 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 26955 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 26956 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 26957 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 26958 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 26959 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 26960 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 26961 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 26962 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 26963 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 26964 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 26965 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 26966 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 26967 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 26968 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 26969 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 26970 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 26971 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 26972 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 26973 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 26974 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 26975 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 26976 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 26977 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 26978 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 26979 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 26980 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 26981 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 26982 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 26983 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 26984 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 26985 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 26986 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 26987 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 26988 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 26989 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 26990 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 26991 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 26992 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 26993 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 26994 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 26995 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 26996 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 26997 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 26998 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 26999 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 27000 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 27001 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 27002 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 27003 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 27004 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 27005 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 27006 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 27007 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 27008 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 27009 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 27010 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 27011 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 27012 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 27013 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 27014 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 27015 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 27016 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 27017 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 27018 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 27019 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 27020 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 27021 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 27022 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 27023 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 27024 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 27025 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 27026 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 27027 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 27028 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 27029 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 27030 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 27031 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 27032 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 27033 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 27034 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 27035 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 27036 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 27037 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 27038 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 27039 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 27040 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 27041 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 27042 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 27043 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 27044 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 27045 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 27046 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 27047 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 27048 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 27049 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 27050 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 27051 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 27052 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 27053 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 27054 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 27055 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 27056 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 27057 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 27058 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 27059 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 27060 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 27061 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 27062 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 27063 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 27064 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 27065 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 27066 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 27067 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 27068 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 27069 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 27070 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 27071 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 27072 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 27073 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 27074 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 27075 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 27076 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 27077 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 27078 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 27079 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 27080 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 27081 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 27082 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 27083 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 27084 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 27085 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 27086 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 27087 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 27088 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 27089 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 27090 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 27091 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 27092 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 27093 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 27094 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 27095 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 27096 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 27097 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 27098 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 27099 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 27100 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 27101 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 27102 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 27103 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 27104 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 27105 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 27106 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 27107 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 27108 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 27109 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 27110 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 27111 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 27112 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 27113 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 27114 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 27115 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 27116 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 27117 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 27118 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 27119 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 27120 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 27121 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 27122 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 27123 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 27124 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 27125 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 27126 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 27127 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 27128 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 27129 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 27130 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 27131 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 27132 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 27133 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 27134 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 27135 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 27136 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 27137 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 27138 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 27139 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 27140 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 27141 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 27142 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 27143 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 27144 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 27145 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 27146 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 27147 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 27148 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 27149 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 27150 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 27151 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 27152 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 27153 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 27154 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 27155 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 27156 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 27157 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 27158 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 27159 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 27160 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 27161 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 27162 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 27163 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 27164 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 27165 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 27166 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 27167 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 27168 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 27169 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 27170 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 27171 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 27172 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 27173 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 27174 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 27175 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 27176 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 27177 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 27178 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 27179 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 27180 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 27181 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 27182 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 27183 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 27184 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 27185 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 27186 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 27187 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 27188 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 27189 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 27190 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 27191 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 27192 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 27193 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 27194 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 27195 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 27196 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 27197 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 27198 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 27199 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 27200 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 27201 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 27202 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 27203 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 27204 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 27205 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 27206 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 27207 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 27208 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 27209 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 27210 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 27211 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 27212 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 27213 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 27214 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 27215 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 27216 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 27217 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 27218 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 27219 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 27220 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 27221 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 27222 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 27223 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 27224 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 27225 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 27226 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 27227 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 27228 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 27229 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 27230 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 27231 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 27232 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 27233 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 27234 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 27235 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 27236 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 27237 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 27238 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 27239 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 27240 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 27241 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 27242 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 27243 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 27244 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 27245 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 27246 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 27247 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 27248 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 27249 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 27250 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 27251 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 27252 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 27253 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 27254 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 27255 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 27256 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 27257 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 27258 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 27259 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 27260 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 27261 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 27262 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 27263 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 27264 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 27265 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 27266 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 27267 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 27268 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 27269 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 27270 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 27271 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 27272 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 27273 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 27274 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 27275 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 27276 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 27277 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 27278 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 27279 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 27280 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 27281 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 27282 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 27283 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 27284 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 27285 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 27286 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 27287 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 27288 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 27289 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 27290 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 27291 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 27292 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 27293 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 27294 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 27295 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 27296 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 27297 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 27298 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 27299 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 27300 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 27301 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 27302 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 27303 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 27304 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 27305 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 27306 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 27307 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 27308 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 27309 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 27310 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 27311 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 27312 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 27313 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 27314 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 27315 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 27316 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 27317 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 27318 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 27319 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 27320 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 27321 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 27322 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 27323 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 27324 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 27325 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 27326 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 27327 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 27328 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 27329 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 27330 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 27331 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 27332 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 27333 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 27334 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 27335 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 27336 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 27337 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 27338 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 27339 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 27340 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 27341 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 27342 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 27343 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 27344 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 27345 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 27346 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 27347 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 27348 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 27349 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 27350 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 27351 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 27352 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 27353 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 27354 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 27355 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 27356 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 27357 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 27358 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 27359 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 27360 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 27361 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 27362 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 27363 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 27364 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 27365 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 27366 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 27367 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 27368 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 27369 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 27370 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 27371 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 27372 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 27373 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 27374 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 27375 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 27376 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 27377 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 27378 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 27379 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 27380 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 27381 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 27382 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 27383 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 27384 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 27385 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 27386 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 27387 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 27388 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 27389 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 27390 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 27391 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 27392 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 27393 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 27394 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 27395 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 27396 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 27397 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 27398 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 27399 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 27400 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 27401 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 27402 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 27403 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 27404 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 27405 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 27406 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 27407 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 27408 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 27409 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 27410 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 27411 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 27412 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 27413 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 27414 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 27415 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 27416 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 27417 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 27418 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 27419 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 27420 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 27421 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 27422 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 27423 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 27424 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 27425 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 27426 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 27427 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 27428 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 27429 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 27430 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 27431 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 27432 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 27433 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 27434 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 27435 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 27436 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 27437 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 27438 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 27439 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 27440 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 27441 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 27442 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 27443 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 27444 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 27445 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 27446 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 27447 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 27448 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 27449 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 27450 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 27451 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 27452 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 27453 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 27454 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 27455 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 27456 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 27457 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 27458 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 27459 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 27460 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 27461 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 27462 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 27463 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 27464 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 27465 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 27466 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 27467 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 27468 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 27469 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 27470 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 27471 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 27472 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 27473 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 27474 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 27475 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 27476 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 27477 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 27478 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 27479 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 27480 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 27481 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 27482 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 27483 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 27484 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 27485 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 27486 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 27487 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 27488 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 27489 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 27490 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 27491 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 27492 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 27493 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 27494 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 27495 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 27496 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 27497 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 27498 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 27499 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 27500 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 27501 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 27502 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 27503 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 27504 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 27505 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 27506 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 27507 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 27508 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 27509 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 27510 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 27511 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 27512 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 27513 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 27514 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 27515 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 27516 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 27517 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 27518 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 27519 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 27520 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 27521 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 27522 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 27523 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 27524 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 27525 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 27526 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 27527 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 27528 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 27529 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 27530 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 27531 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 27532 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 27533 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 27534 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 27535 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 27536 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 27537 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 27538 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 27539 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 27540 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 27541 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 27542 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 27543 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 27544 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 27545 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 27546 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 27547 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 27548 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 27549 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 27550 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 27551 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 27552 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 27553 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 27554 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 27555 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 27556 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 27557 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 27558 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 27559 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 27560 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 27561 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 27562 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 27563 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 27564 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 27565 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 27566 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 27567 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 27568 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 27569 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 27570 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 27571 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 27572 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 27573 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 27574 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 27575 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 27576 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 27577 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 27578 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 27579 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 27580 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 27581 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 27582 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 27583 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 27584 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 27585 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 27586 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 27587 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 27588 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 27589 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 27590 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 27591 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 27592 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 27593 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 27594 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 27595 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 27596 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 27597 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 27598 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 27599 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 27600 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 27601 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 27602 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 27603 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 27604 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 27605 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 27606 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 27607 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 27608 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 27609 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 27610 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 27611 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 27612 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 27613 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 27614 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 27615 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 27616 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 27617 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 27618 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 27619 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 27620 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 27621 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 27622 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 27623 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 27624 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 27625 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 27626 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 27627 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 27628 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 27629 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 27630 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 27631 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 27632 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 27633 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 27634 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 27635 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 27636 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 27637 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 27638 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 27639 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 27640 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 27641 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 27642 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 27643 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 27644 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 27645 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 27646 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 27647 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 27648 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 27649 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 27650 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 27651 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 27652 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 27653 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 27654 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 27655 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 27656 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 27657 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 27658 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 27659 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 27660 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 27661 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 27662 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 27663 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 27664 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 27665 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 27666 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 27667 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 27668 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 27669 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 27670 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 27671 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 27672 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 27673 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 27674 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 27675 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 27676 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 27677 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 27678 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 27679 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 27680 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 27681 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 27682 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 27683 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 27684 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 27685 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 27686 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 27687 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 27688 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 27689 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 27690 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 27691 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 27692 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 27693 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 27694 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 27695 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 27696 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 27697 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 27698 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 27699 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 27700 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 27701 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 27702 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 27703 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 27704 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 27705 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 27706 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 27707 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 27708 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 27709 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 27710 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 27711 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 27712 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 27713 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 27714 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 27715 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 27716 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 27717 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 27718 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 27719 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 27720 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 27721 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 27722 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 27723 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 27724 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 27725 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 27726 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 27727 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 27728 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 27729 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 27730 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 27731 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 27732 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 27733 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 27734 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 27735 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 27736 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 27737 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 27738 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 27739 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 27740 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 27741 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 27742 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 27743 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 27744 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 27745 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 27746 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 27747 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 27748 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 27749 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 27750 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 27751 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 27752 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 27753 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 27754 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 27755 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 27756 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 27757 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 27758 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 27759 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 27760 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 27761 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 27762 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 27763 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 27764 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 27765 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 27766 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 27767 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 27768 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 27769 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 27770 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 27771 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 27772 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 27773 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 27774 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 27775 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 27776 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 27777 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 27778 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 27779 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 27780 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 27781 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 27782 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 27783 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 27784 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 27785 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 27786 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 27787 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 27788 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 27789 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 27790 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 27791 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 27792 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 27793 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 27794 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 27795 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 27796 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 27797 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 27798 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 27799 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 27800 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 27801 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 27802 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 27803 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 27804 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 27805 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 27806 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 27807 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 27808 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 27809 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 27810 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 27811 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 27812 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 27813 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 27814 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 27815 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 27816 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 27817 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 27818 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 27819 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 27820 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 27821 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 27822 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 27823 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 27824 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 27825 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 27826 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 27827 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 27828 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 27829 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 27830 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 27831 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 27832 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 27833 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 27834 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 27835 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 27836 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 27837 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 27838 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 27839 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 27840 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 27841 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 27842 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 27843 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 27844 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 27845 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 27846 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 27847 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 27848 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 27849 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 27850 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 27851 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 27852 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 27853 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 27854 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 27855 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 27856 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 27857 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 27858 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 27859 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 27860 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 27861 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 27862 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 27863 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 27864 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 27865 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 27866 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 27867 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 27868 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 27869 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 27870 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 27871 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 27872 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 27873 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 27874 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 27875 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 27876 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 27877 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 27878 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 27879 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 27880 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 27881 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 27882 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 27883 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 27884 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 27885 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 27886 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 27887 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 27888 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 27889 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 27890 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 27891 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 27892 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 27893 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 27894 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 27895 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 27896 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 27897 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 27898 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 27899 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 27900 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 27901 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 27902 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 27903 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 27904 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 27905 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 27906 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 27907 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 27908 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 27909 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 27910 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 27911 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 27912 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 27913 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 27914 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 27915 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 27916 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 27917 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 27918 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 27919 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 27920 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 27921 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 27922 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 27923 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 27924 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 27925 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 27926 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 27927 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 27928 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 27929 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 27930 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 27931 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 27932 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 27933 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 27934 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 27935 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 27936 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 27937 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 27938 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 27939 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 27940 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 27941 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 27942 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 27943 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 27944 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 27945 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 27946 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 27947 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 27948 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 27949 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 27950 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 27951 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 27952 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 27953 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 27954 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 27955 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 27956 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 27957 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 27958 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 27959 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 27960 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 27961 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 27962 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 27963 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 27964 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 27965 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 27966 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 27967 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 27968 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 27969 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 27970 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 27971 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 27972 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 27973 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 27974 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 27975 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 27976 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 27977 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 27978 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 27979 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 27980 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 27981 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 27982 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 27983 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 27984 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 27985 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 27986 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 27987 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 27988 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 27989 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 27990 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 27991 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 27992 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 27993 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 27994 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 27995 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 27996 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 27997 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 27998 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 27999 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 28000 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 28001 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 28002 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 28003 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 28004 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 28005 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 28006 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 28007 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 28008 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 28009 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 28010 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 28011 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 28012 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 28013 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 28014 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 28015 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 28016 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 28017 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 28018 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 28019 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 28020 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 28021 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 28022 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 28023 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 28024 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 28025 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 28026 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 28027 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 28028 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 28029 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 28030 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 28031 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 28032 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 28033 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 28034 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 28035 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 28036 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 28037 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 28038 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 28039 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 28040 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 28041 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 28042 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 28043 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 28044 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 28045 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 28046 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 28047 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 28048 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 28049 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 28050 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 28051 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 28052 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 28053 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 28054 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 28055 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 28056 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 28057 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 28058 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 28059 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 28060 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 28061 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 28062 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 28063 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 28064 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 28065 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 28066 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 28067 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 28068 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 28069 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 28070 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 28071 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 28072 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 28073 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 28074 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 28075 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 28076 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 28077 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 28078 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 28079 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 28080 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 28081 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 28082 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 28083 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 28084 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 28085 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 28086 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 28087 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 28088 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 28089 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 28090 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 28091 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 28092 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 28093 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 28094 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 28095 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 28096 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 28097 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 28098 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 28099 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 28100 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 28101 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 28102 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 28103 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 28104 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 28105 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 28106 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 28107 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 28108 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 28109 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 28110 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 28111 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 28112 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 28113 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 28114 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 28115 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 28116 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 28117 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 28118 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 28119 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 28120 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 28121 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 28122 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 28123 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 28124 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 28125 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 28126 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 28127 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 28128 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 28129 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 28130 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 28131 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 28132 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 28133 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 28134 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 28135 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 28136 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 28137 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 28138 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 28139 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 28140 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 28141 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 28142 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 28143 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 28144 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 28145 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 28146 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 28147 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 28148 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 28149 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 28150 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 28151 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 28152 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 28153 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 28154 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 28155 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 28156 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 28157 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 28158 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 28159 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 28160 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 28161 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 28162 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 28163 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 28164 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 28165 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 28166 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 28167 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 28168 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 28169 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 28170 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 28171 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 28172 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 28173 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 28174 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 28175 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 28176 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 28177 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 28178 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 28179 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 28180 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 28181 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 28182 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 28183 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 28184 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 28185 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 28186 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 28187 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 28188 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 28189 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 28190 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 28191 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 28192 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 28193 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 28194 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 28195 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 28196 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 28197 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 28198 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 28199 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 28200 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 28201 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 28202 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 28203 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 28204 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 28205 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 28206 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 28207 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 28208 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 28209 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 28210 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 28211 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 28212 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 28213 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 28214 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 28215 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 28216 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 28217 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 28218 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 28219 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 28220 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 28221 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 28222 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 28223 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 28224 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 28225 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 28226 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 28227 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 28228 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 28229 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 28230 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 28231 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 28232 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 28233 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 28234 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 28235 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 28236 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 28237 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 28238 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 28239 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 28240 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 28241 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 28242 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 28243 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 28244 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 28245 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 28246 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 28247 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 28248 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 28249 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 28250 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 28251 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 28252 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 28253 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 28254 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 28255 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 28256 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 28257 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 28258 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 28259 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 28260 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 28261 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 28262 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 28263 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 28264 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 28265 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 28266 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 28267 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 28268 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 28269 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 28270 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 28271 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 28272 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 28273 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 28274 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 28275 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 28276 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 28277 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 28278 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 28279 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 28280 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 28281 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 28282 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 28283 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 28284 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 28285 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 28286 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 28287 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 28288 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 28289 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 28290 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 28291 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 28292 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 28293 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 28294 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 28295 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 28296 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 28297 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 28298 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 28299 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 28300 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 28301 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 28302 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 28303 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 28304 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 28305 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 28306 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 28307 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 28308 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 28309 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 28310 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 28311 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 28312 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 28313 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 28314 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 28315 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 28316 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 28317 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 28318 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 28319 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 28320 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 28321 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 28322 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 28323 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 28324 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 28325 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 28326 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 28327 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 28328 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 28329 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 28330 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 28331 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 28332 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 28333 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 28334 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 28335 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 28336 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 28337 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 28338 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 28339 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 28340 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 28341 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 28342 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 28343 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 28344 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 28345 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 28346 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 28347 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 28348 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 28349 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 28350 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 28351 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 28352 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 28353 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 28354 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 28355 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 28356 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 28357 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 28358 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 28359 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 28360 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 28361 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 28362 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 28363 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 28364 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 28365 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 28366 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 28367 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 28368 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 28369 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 28370 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 28371 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 28372 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 28373 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 28374 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 28375 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 28376 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 28377 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 28378 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 28379 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 28380 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 28381 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 28382 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 28383 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 28384 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 28385 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 28386 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 28387 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 28388 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 28389 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 28390 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 28391 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 28392 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 28393 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 28394 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 28395 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 28396 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 28397 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 28398 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 28399 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 28400 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 28401 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 28402 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 28403 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 28404 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 28405 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 28406 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 28407 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 28408 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 28409 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 28410 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 28411 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 28412 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 28413 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 28414 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 28415 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 28416 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 28417 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 28418 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 28419 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 28420 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 28421 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 28422 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 28423 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 28424 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 28425 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 28426 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 28427 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 28428 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 28429 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 28430 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 28431 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 28432 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 28433 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 28434 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 28435 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 28436 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 28437 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 28438 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 28439 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 28440 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 28441 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 28442 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 28443 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 28444 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 28445 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 28446 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 28447 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 28448 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 28449 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 28450 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 28451 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 28452 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 28453 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 28454 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 28455 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 28456 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 28457 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 28458 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 28459 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 28460 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 28461 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 28462 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 28463 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 28464 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 28465 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 28466 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 28467 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 28468 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 28469 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 28470 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 28471 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 28472 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 28473 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 28474 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 28475 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 28476 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 28477 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 28478 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 28479 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 28480 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 28481 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 28482 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 28483 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 28484 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 28485 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 28486 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 28487 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 28488 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 28489 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 28490 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 28491 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 28492 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 28493 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 28494 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 28495 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 28496 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 28497 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 28498 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 28499 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 28500 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 28501 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 28502 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 28503 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 28504 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 28505 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 28506 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 28507 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 28508 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 28509 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 28510 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 28511 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 28512 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 28513 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 28514 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 28515 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 28516 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 28517 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 28518 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 28519 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 28520 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 28521 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 28522 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 28523 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 28524 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 28525 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 28526 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 28527 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 28528 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 28529 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 28530 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 28531 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 28532 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 28533 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 28534 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 28535 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 28536 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 28537 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 28538 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 28539 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 28540 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 28541 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 28542 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 28543 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 28544 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 28545 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 28546 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 28547 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 28548 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 28549 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 28550 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 28551 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 28552 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 28553 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 28554 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 28555 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 28556 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 28557 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 28558 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 28559 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 28560 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 28561 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 28562 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 28563 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 28564 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 28565 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 28566 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 28567 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 28568 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 28569 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 28570 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 28571 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 28572 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 28573 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 28574 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 28575 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 28576 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 28577 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 28578 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 28579 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 28580 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 28581 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 28582 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 28583 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 28584 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 28585 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 28586 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 28587 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 28588 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 28589 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 28590 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 28591 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 28592 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 28593 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 28594 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 28595 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 28596 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 28597 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 28598 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 28599 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 28600 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 28601 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 28602 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 28603 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 28604 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 28605 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 28606 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 28607 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 28608 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 28609 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 28610 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 28611 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 28612 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 28613 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 28614 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 28615 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 28616 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 28617 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 28618 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 28619 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 28620 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 28621 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 28622 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 28623 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 28624 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 28625 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 28626 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 28627 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 28628 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 28629 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 28630 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 28631 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 28632 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 28633 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 28634 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 28635 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 28636 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 28637 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 28638 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 28639 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 28640 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 28641 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 28642 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 28643 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 28644 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 28645 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 28646 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 28647 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 28648 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 28649 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 28650 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 28651 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 28652 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 28653 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 28654 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 28655 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 28656 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 28657 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 28658 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 28659 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 28660 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 28661 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 28662 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 28663 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 28664 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 28665 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 28666 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 28667 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 28668 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 28669 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 28670 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 28671 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 28672 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 28673 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 28674 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 28675 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 28676 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 28677 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 28678 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 28679 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 28680 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 28681 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 28682 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 28683 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 28684 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 28685 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 28686 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 28687 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 28688 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 28689 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 28690 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 28691 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 28692 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 28693 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 28694 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 28695 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 28696 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 28697 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 28698 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 28699 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 28700 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 28701 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 28702 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 28703 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 28704 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 28705 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 28706 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 28707 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 28708 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 28709 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 28710 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 28711 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 28712 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 28713 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 28714 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 28715 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 28716 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 28717 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 28718 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 28719 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 28720 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 28721 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 28722 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 28723 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 28724 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 28725 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 28726 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 28727 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 28728 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 28729 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 28730 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 28731 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 28732 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 28733 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 28734 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 28735 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 28736 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 28737 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 28738 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 28739 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 28740 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 28741 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 28742 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 28743 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 28744 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 28745 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 28746 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 28747 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 28748 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 28749 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 28750 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 28751 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 28752 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 28753 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 28754 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 28755 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 28756 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 28757 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 28758 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 28759 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 28760 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 28761 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 28762 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 28763 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 28764 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 28765 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 28766 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 28767 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 28768 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 28769 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 28770 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 28771 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 28772 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 28773 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 28774 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 28775 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 28776 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 28777 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 28778 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 28779 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 28780 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 28781 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 28782 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 28783 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 28784 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 28785 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 28786 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 28787 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 28788 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 28789 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 28790 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 28791 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 28792 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 28793 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 28794 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 28795 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 28796 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 28797 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 28798 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 28799 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 28800 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 28801 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 28802 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 28803 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 28804 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 28805 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 28806 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 28807 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 28808 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 28809 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 28810 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 28811 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 28812 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 28813 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 28814 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 28815 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 28816 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 28817 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 28818 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 28819 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 28820 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 28821 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 28822 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 28823 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 28824 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 28825 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 28826 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 28827 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 28828 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 28829 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 28830 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 28831 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 28832 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 28833 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 28834 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 28835 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 28836 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 28837 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 28838 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 28839 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 28840 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 28841 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 28842 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 28843 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 28844 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 28845 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 28846 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 28847 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 28848 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 28849 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 28850 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 28851 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 28852 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 28853 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 28854 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 28855 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 28856 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 28857 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 28858 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 28859 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 28860 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 28861 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 28862 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 28863 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 28864 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 28865 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 28866 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 28867 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 28868 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 28869 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 28870 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 28871 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 28872 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 28873 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 28874 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 28875 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 28876 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 28877 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 28878 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 28879 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 28880 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 28881 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 28882 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 28883 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 28884 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 28885 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 28886 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 28887 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 28888 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 28889 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 28890 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 28891 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 28892 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 28893 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 28894 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 28895 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 28896 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 28897 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 28898 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 28899 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 28900 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 28901 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 28902 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 28903 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 28904 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 28905 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 28906 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 28907 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 28908 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 28909 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 28910 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 28911 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 28912 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 28913 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 28914 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 28915 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 28916 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 28917 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 28918 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 28919 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 28920 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 28921 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 28922 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 28923 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 28924 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 28925 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 28926 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 28927 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 28928 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 28929 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 28930 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 28931 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 28932 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 28933 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 28934 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 28935 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 28936 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 28937 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 28938 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 28939 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 28940 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 28941 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 28942 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 28943 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 28944 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 28945 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 28946 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 28947 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 28948 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 28949 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 28950 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 28951 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 28952 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 28953 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 28954 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 28955 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 28956 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 28957 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 28958 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 28959 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 28960 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 28961 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 28962 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 28963 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 28964 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 28965 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 28966 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 28967 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 28968 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 28969 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 28970 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 28971 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 28972 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 28973 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 28974 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 28975 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 28976 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 28977 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 28978 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 28979 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 28980 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 28981 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 28982 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 28983 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 28984 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 28985 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 28986 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 28987 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 28988 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 28989 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 28990 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 28991 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 28992 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 28993 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 28994 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 28995 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 28996 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 28997 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 28998 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 28999 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 29000 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 29001 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 29002 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 29003 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 29004 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 29005 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 29006 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 29007 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 29008 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 29009 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 29010 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 29011 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 29012 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 29013 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 29014 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 29015 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 29016 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 29017 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 29018 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 29019 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 29020 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 29021 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 29022 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 29023 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 29024 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 29025 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 29026 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 29027 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 29028 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 29029 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 29030 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 29031 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 29032 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 29033 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 29034 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 29035 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 29036 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 29037 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 29038 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 29039 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 29040 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 29041 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 29042 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 29043 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 29044 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 29045 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 29046 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 29047 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 29048 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 29049 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 29050 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 29051 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 29052 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 29053 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 29054 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 29055 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 29056 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 29057 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 29058 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 29059 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 29060 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 29061 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 29062 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 29063 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 29064 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 29065 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 29066 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 29067 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 29068 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 29069 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 29070 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 29071 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 29072 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 29073 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 29074 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 29075 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 29076 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 29077 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 29078 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 29079 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 29080 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 29081 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 29082 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 29083 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 29084 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 29085 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 29086 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 29087 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 29088 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 29089 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 29090 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 29091 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 29092 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 29093 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 29094 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 29095 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 29096 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 29097 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 29098 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 29099 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 29100 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 29101 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 29102 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 29103 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 29104 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 29105 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 29106 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 29107 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 29108 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 29109 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 29110 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 29111 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 29112 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 29113 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 29114 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 29115 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 29116 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 29117 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 29118 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 29119 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 29120 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 29121 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 29122 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 29123 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 29124 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 29125 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 29126 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 29127 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 29128 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 29129 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 29130 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 29131 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 29132 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 29133 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 29134 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 29135 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 29136 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 29137 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 29138 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 29139 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 29140 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 29141 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 29142 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 29143 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 29144 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 29145 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 29146 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 29147 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 29148 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 29149 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 29150 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 29151 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 29152 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 29153 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 29154 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 29155 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 29156 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 29157 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 29158 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 29159 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 29160 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 29161 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 29162 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 29163 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 29164 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 29165 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 29166 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 29167 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 29168 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 29169 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 29170 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 29171 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 29172 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 29173 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 29174 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 29175 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 29176 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 29177 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 29178 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 29179 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 29180 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 29181 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 29182 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 29183 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 29184 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 29185 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 29186 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 29187 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 29188 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 29189 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 29190 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 29191 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 29192 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 29193 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 29194 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 29195 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 29196 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 29197 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 29198 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 29199 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 29200 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 29201 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 29202 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 29203 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 29204 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 29205 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 29206 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 29207 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 29208 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 29209 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 29210 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 29211 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 29212 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 29213 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 29214 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 29215 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 29216 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 29217 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 29218 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 29219 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 29220 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 29221 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 29222 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 29223 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 29224 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 29225 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 29226 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 29227 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 29228 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 29229 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 29230 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 29231 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 29232 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 29233 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 29234 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 29235 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 29236 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 29237 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 29238 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 29239 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 29240 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 29241 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 29242 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 29243 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 29244 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 29245 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 29246 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 29247 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 29248 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 29249 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 29250 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 29251 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 29252 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 29253 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 29254 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 29255 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 29256 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 29257 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 29258 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 29259 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 29260 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 29261 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 29262 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 29263 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 29264 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 29265 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 29266 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 29267 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 29268 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 29269 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 29270 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 29271 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 29272 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 29273 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 29274 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 29275 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 29276 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 29277 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 29278 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 29279 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 29280 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 29281 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 29282 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 29283 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 29284 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 29285 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 29286 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 29287 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 29288 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 29289 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 29290 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 29291 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 29292 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 29293 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 29294 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 29295 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 29296 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 29297 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 29298 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 29299 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 29300 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 29301 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 29302 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 29303 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 29304 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 29305 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 29306 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 29307 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 29308 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 29309 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 29310 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 29311 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 29312 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 29313 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 29314 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 29315 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 29316 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 29317 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 29318 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 29319 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 29320 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 29321 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 29322 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 29323 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 29324 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 29325 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 29326 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 29327 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 29328 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 29329 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 29330 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 29331 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 29332 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 29333 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 29334 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 29335 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 29336 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 29337 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 29338 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 29339 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 29340 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 29341 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 29342 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 29343 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 29344 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 29345 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 29346 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 29347 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 29348 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 29349 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 29350 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 29351 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 29352 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 29353 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 29354 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 29355 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 29356 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 29357 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 29358 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 29359 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 29360 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 29361 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 29362 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 29363 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 29364 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 29365 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 29366 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 29367 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 29368 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 29369 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 29370 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 29371 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 29372 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 29373 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 29374 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 29375 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 29376 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 29377 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 29378 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 29379 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 29380 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 29381 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 29382 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 29383 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 29384 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 29385 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 29386 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 29387 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 29388 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 29389 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 29390 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 29391 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 29392 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 29393 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 29394 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 29395 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 29396 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 29397 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 29398 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 29399 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 29400 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 29401 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 29402 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 29403 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 29404 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 29405 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 29406 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 29407 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 29408 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 29409 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 29410 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 29411 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 29412 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 29413 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 29414 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 29415 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 29416 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 29417 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 29418 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 29419 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 29420 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 29421 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 29422 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 29423 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 29424 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 29425 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 29426 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 29427 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 29428 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 29429 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 29430 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 29431 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 29432 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 29433 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 29434 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 29435 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 29436 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 29437 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 29438 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 29439 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 29440 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 29441 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 29442 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 29443 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 29444 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 29445 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 29446 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 29447 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 29448 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 29449 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 29450 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 29451 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 29452 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 29453 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 29454 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 29455 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 29456 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 29457 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 29458 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 29459 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 29460 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 29461 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 29462 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 29463 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 29464 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 29465 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 29466 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 29467 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 29468 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 29469 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 29470 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 29471 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 29472 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 29473 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 29474 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 29475 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 29476 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 29477 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 29478 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 29479 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 29480 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 29481 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 29482 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 29483 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 29484 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 29485 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 29486 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 29487 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 29488 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 29489 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 29490 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 29491 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 29492 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 29493 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 29494 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 29495 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 29496 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 29497 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 29498 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 29499 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 29500 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 29501 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 29502 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 29503 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 29504 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 29505 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 29506 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 29507 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 29508 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 29509 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 29510 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 29511 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 29512 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 29513 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 29514 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 29515 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 29516 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 29517 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 29518 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 29519 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 29520 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 29521 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 29522 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 29523 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 29524 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 29525 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 29526 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 29527 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 29528 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 29529 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 29530 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 29531 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 29532 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 29533 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 29534 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 29535 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 29536 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 29537 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 29538 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 29539 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 29540 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 29541 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 29542 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 29543 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 29544 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 29545 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 29546 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 29547 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 29548 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 29549 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 29550 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 29551 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 29552 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 29553 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 29554 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 29555 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 29556 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 29557 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 29558 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 29559 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 29560 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 29561 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 29562 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 29563 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 29564 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 29565 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 29566 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 29567 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 29568 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 29569 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 29570 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 29571 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 29572 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 29573 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 29574 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 29575 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 29576 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 29577 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 29578 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 29579 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 29580 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 29581 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 29582 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 29583 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 29584 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 29585 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 29586 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 29587 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 29588 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 29589 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 29590 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 29591 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 29592 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 29593 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 29594 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 29595 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 29596 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 29597 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 29598 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 29599 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 29600 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 29601 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 29602 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 29603 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 29604 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 29605 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 29606 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 29607 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 29608 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 29609 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 29610 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 29611 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 29612 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 29613 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 29614 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 29615 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 29616 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 29617 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 29618 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 29619 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 29620 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 29621 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 29622 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 29623 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 29624 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 29625 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 29626 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 29627 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 29628 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 29629 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 29630 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 29631 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 29632 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 29633 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 29634 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 29635 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 29636 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 29637 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 29638 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 29639 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 29640 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 29641 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 29642 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 29643 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 29644 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 29645 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 29646 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 29647 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 29648 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 29649 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 29650 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 29651 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 29652 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 29653 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 29654 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 29655 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 29656 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 29657 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 29658 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 29659 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 29660 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 29661 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 29662 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 29663 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 29664 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 29665 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 29666 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 29667 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 29668 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 29669 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 29670 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 29671 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 29672 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 29673 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 29674 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 29675 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 29676 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 29677 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 29678 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 29679 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 29680 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 29681 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 29682 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 29683 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 29684 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 29685 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 29686 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 29687 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 29688 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 29689 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 29690 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 29691 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 29692 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 29693 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 29694 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 29695 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 29696 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 29697 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 29698 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 29699 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 29700 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 29701 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 29702 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 29703 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 29704 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 29705 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 29706 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 29707 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 29708 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 29709 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 29710 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 29711 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 29712 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 29713 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 29714 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 29715 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 29716 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 29717 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 29718 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 29719 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 29720 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 29721 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 29722 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 29723 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 29724 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 29725 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 29726 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 29727 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 29728 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 29729 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 29730 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 29731 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 29732 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 29733 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 29734 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 29735 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 29736 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 29737 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 29738 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 29739 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 29740 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 29741 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 29742 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 29743 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 29744 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 29745 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 29746 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 29747 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 29748 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 29749 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 29750 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 29751 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 29752 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 29753 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 29754 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 29755 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 29756 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 29757 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 29758 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 29759 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 29760 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 29761 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 29762 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 29763 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 29764 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 29765 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 29766 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 29767 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 29768 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 29769 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 29770 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 29771 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 29772 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 29773 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 29774 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 29775 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 29776 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 29777 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 29778 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 29779 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 29780 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 29781 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 29782 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 29783 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 29784 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 29785 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 29786 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 29787 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 29788 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 29789 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 29790 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 29791 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 29792 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 29793 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 29794 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 29795 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 29796 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 29797 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 29798 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 29799 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 29800 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 29801 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 29802 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 29803 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 29804 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 29805 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 29806 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 29807 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 29808 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 29809 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 29810 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 29811 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 29812 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 29813 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 29814 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 29815 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 29816 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 29817 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 29818 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 29819 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 29820 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 29821 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 29822 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 29823 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 29824 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 29825 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 29826 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 29827 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 29828 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 29829 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 29830 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 29831 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 29832 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 29833 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 29834 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 29835 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 29836 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 29837 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 29838 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 29839 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 29840 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 29841 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 29842 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 29843 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 29844 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 29845 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 29846 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 29847 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 29848 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 29849 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 29850 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 29851 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 29852 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 29853 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 29854 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 29855 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 29856 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 29857 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 29858 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 29859 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 29860 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 29861 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 29862 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 29863 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 29864 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 29865 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 29866 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 29867 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 29868 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 29869 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 29870 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 29871 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 29872 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 29873 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 29874 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 29875 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 29876 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 29877 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 29878 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 29879 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 29880 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 29881 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 29882 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 29883 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 29884 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 29885 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 29886 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 29887 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 29888 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 29889 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 29890 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 29891 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 29892 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 29893 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 29894 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 29895 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 29896 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 29897 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 29898 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 29899 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 29900 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 29901 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 29902 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 29903 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 29904 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 29905 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 29906 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 29907 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 29908 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 29909 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 29910 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 29911 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 29912 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 29913 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 29914 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 29915 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 29916 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 29917 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 29918 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 29919 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 29920 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 29921 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 29922 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 29923 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 29924 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 29925 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 29926 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 29927 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 29928 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 29929 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 29930 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 29931 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 29932 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 29933 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 29934 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 29935 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 29936 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 29937 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 29938 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 29939 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 29940 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 29941 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 29942 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 29943 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 29944 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 29945 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 29946 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 29947 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 29948 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 29949 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 29950 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 29951 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 29952 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 29953 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 29954 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 29955 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 29956 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 29957 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 29958 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 29959 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 29960 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 29961 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 29962 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 29963 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 29964 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 29965 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 29966 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 29967 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 29968 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 29969 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 29970 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 29971 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 29972 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 29973 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 29974 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 29975 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 29976 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 29977 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 29978 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 29979 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 29980 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 29981 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 29982 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 29983 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 29984 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 29985 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 29986 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 29987 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 29988 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 29989 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 29990 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 29991 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 29992 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 29993 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 29994 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 29995 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 29996 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 29997 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 29998 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 29999 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 30000 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 30001 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 30002 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 30003 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 30004 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 30005 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 30006 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 30007 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 30008 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 30009 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 30010 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 30011 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 30012 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 30013 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 30014 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 30015 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 30016 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 30017 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 30018 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 30019 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 30020 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 30021 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 30022 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 30023 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 30024 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 30025 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 30026 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 30027 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 30028 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 30029 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 30030 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 30031 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 30032 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 30033 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 30034 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 30035 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 30036 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 30037 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 30038 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 30039 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 30040 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 30041 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 30042 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 30043 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 30044 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 30045 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 30046 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 30047 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 30048 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 30049 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 30050 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 30051 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 30052 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 30053 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 30054 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 30055 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 30056 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 30057 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 30058 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 30059 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 30060 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 30061 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 30062 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 30063 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 30064 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 30065 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 30066 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 30067 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 30068 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 30069 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 30070 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 30071 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 30072 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 30073 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 30074 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 30075 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 30076 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 30077 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 30078 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 30079 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 30080 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 30081 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 30082 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 30083 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 30084 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 30085 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 30086 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 30087 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 30088 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 30089 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 30090 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 30091 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 30092 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 30093 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 30094 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 30095 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 30096 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 30097 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 30098 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 30099 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 30100 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 30101 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 30102 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 30103 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 30104 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 30105 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 30106 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 30107 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 30108 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 30109 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 30110 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 30111 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 30112 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 30113 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 30114 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 30115 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 30116 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 30117 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 30118 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 30119 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 30120 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 30121 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 30122 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 30123 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 30124 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 30125 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 30126 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 30127 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 30128 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 30129 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 30130 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 30131 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 30132 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 30133 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 30134 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 30135 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 30136 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 30137 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 30138 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 30139 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 30140 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 30141 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 30142 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 30143 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 30144 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 30145 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 30146 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 30147 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 30148 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 30149 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 30150 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 30151 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 30152 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 30153 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 30154 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 30155 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 30156 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 30157 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 30158 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 30159 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 30160 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 30161 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 30162 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 30163 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 30164 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 30165 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 30166 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 30167 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 30168 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 30169 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 30170 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 30171 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 30172 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 30173 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 30174 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 30175 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 30176 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 30177 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 30178 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 30179 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 30180 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 30181 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 30182 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 30183 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 30184 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 30185 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 30186 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 30187 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 30188 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 30189 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 30190 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 30191 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 30192 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 30193 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 30194 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 30195 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 30196 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 30197 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 30198 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 30199 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 30200 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 30201 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 30202 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 30203 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 30204 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 30205 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 30206 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 30207 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 30208 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 30209 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 30210 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 30211 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 30212 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 30213 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 30214 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 30215 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 30216 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 30217 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 30218 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 30219 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 30220 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 30221 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 30222 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 30223 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 30224 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 30225 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 30226 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 30227 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 30228 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 30229 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 30230 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 30231 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 30232 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 30233 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 30234 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 30235 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 30236 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 30237 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 30238 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 30239 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 30240 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 30241 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 30242 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 30243 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 30244 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 30245 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 30246 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 30247 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 30248 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 30249 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 30250 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 30251 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 30252 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 30253 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 30254 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 30255 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 30256 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 30257 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 30258 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 30259 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 30260 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 30261 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 30262 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 30263 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 30264 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 30265 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 30266 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 30267 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 30268 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 30269 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 30270 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 30271 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 30272 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 30273 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 30274 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 30275 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 30276 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 30277 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 30278 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 30279 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 30280 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 30281 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 30282 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 30283 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 30284 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 30285 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 30286 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 30287 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 30288 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 30289 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 30290 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 30291 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 30292 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 30293 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 30294 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 30295 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 30296 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 30297 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 30298 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 30299 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 30300 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 30301 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 30302 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 30303 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 30304 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 30305 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 30306 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 30307 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 30308 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 30309 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 30310 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 30311 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 30312 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 30313 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 30314 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 30315 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 30316 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 30317 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 30318 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 30319 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 30320 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 30321 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 30322 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 30323 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 30324 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 30325 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 30326 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 30327 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 30328 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 30329 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 30330 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 30331 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 30332 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 30333 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 30334 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 30335 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 30336 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 30337 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 30338 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 30339 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 30340 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 30341 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 30342 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 30343 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 30344 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 30345 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 30346 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 30347 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 30348 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 30349 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 30350 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 30351 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 30352 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 30353 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 30354 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 30355 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 30356 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 30357 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 30358 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 30359 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 30360 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 30361 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 30362 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 30363 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 30364 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 30365 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 30366 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 30367 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 30368 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 30369 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 30370 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 30371 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 30372 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 30373 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 30374 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 30375 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 30376 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 30377 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 30378 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 30379 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 30380 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 30381 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 30382 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 30383 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 30384 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 30385 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 30386 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 30387 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 30388 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 30389 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 30390 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 30391 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 30392 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 30393 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 30394 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 30395 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 30396 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 30397 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 30398 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 30399 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 30400 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 30401 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 30402 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 30403 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 30404 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 30405 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 30406 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 30407 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 30408 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 30409 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 30410 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 30411 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 30412 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 30413 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 30414 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 30415 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 30416 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 30417 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 30418 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 30419 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 30420 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 30421 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 30422 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 30423 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 30424 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 30425 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 30426 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 30427 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 30428 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 30429 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 30430 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 30431 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 30432 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 30433 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 30434 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 30435 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 30436 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 30437 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 30438 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 30439 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 30440 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 30441 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 30442 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 30443 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 30444 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 30445 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 30446 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 30447 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 30448 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 30449 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 30450 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 30451 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 30452 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 30453 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 30454 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 30455 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 30456 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 30457 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 30458 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 30459 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 30460 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 30461 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 30462 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 30463 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 30464 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 30465 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 30466 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 30467 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 30468 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 30469 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 30470 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 30471 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 30472 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 30473 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 30474 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 30475 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 30476 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 30477 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 30478 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 30479 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 30480 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 30481 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 30482 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 30483 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 30484 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 30485 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 30486 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 30487 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 30488 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 30489 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 30490 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 30491 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 30492 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 30493 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 30494 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 30495 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 30496 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 30497 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 30498 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 30499 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 30500 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 30501 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 30502 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 30503 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 30504 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 30505 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 30506 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 30507 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 30508 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 30509 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 30510 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 30511 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 30512 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 30513 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 30514 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 30515 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 30516 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 30517 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 30518 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 30519 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 30520 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 30521 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 30522 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 30523 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 30524 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 30525 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 30526 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 30527 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 30528 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 30529 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 30530 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 30531 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 30532 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 30533 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 30534 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 30535 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 30536 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 30537 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 30538 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 30539 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 30540 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 30541 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 30542 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 30543 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 30544 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 30545 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 30546 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 30547 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 30548 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 30549 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 30550 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 30551 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 30552 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 30553 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 30554 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 30555 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 30556 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 30557 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 30558 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 30559 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 30560 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 30561 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 30562 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 30563 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 30564 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 30565 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 30566 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 30567 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 30568 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 30569 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 30570 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 30571 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 30572 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 30573 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 30574 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 30575 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 30576 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 30577 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 30578 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 30579 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 30580 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 30581 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 30582 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 30583 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 30584 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 30585 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 30586 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 30587 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 30588 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 30589 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 30590 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 30591 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 30592 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 30593 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 30594 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 30595 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 30596 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 30597 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 30598 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 30599 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 30600 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 30601 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 30602 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 30603 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 30604 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 30605 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 30606 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 30607 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 30608 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 30609 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 30610 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 30611 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 30612 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 30613 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 30614 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 30615 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 30616 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 30617 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 30618 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 30619 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 30620 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 30621 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 30622 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 30623 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 30624 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 30625 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 30626 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 30627 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 30628 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 30629 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 30630 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 30631 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 30632 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 30633 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 30634 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 30635 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 30636 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 30637 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 30638 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 30639 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 30640 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 30641 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 30642 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 30643 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 30644 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 30645 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 30646 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 30647 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 30648 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 30649 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 30650 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 30651 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 30652 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 30653 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 30654 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 30655 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 30656 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 30657 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 30658 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 30659 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 30660 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 30661 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 30662 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 30663 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 30664 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 30665 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 30666 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 30667 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 30668 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 30669 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 30670 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 30671 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 30672 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 30673 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 30674 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 30675 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 30676 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 30677 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 30678 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 30679 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 30680 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 30681 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 30682 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 30683 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 30684 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 30685 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 30686 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 30687 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 30688 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 30689 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 30690 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 30691 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 30692 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 30693 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 30694 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 30695 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 30696 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 30697 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 30698 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 30699 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 30700 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 30701 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 30702 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 30703 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 30704 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 30705 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 30706 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 30707 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 30708 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 30709 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 30710 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 30711 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 30712 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 30713 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 30714 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 30715 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 30716 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 30717 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 30718 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 30719 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 30720 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 30721 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 30722 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 30723 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 30724 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 30725 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 30726 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 30727 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 30728 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 30729 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 30730 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 30731 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 30732 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 30733 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 30734 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 30735 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 30736 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 30737 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 30738 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 30739 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 30740 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 30741 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 30742 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 30743 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 30744 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 30745 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 30746 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 30747 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 30748 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 30749 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 30750 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 30751 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 30752 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 30753 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 30754 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 30755 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 30756 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 30757 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 30758 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 30759 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 30760 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 30761 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 30762 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 30763 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 30764 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 30765 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 30766 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 30767 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 30768 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 30769 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 30770 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 30771 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 30772 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 30773 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 30774 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 30775 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 30776 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 30777 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 30778 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 30779 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 30780 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 30781 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 30782 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 30783 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 30784 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 30785 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 30786 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 30787 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 30788 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 30789 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 30790 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 30791 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 30792 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 30793 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 30794 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 30795 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 30796 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 30797 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 30798 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 30799 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 30800 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 30801 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 30802 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 30803 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 30804 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 30805 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 30806 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 30807 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 30808 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 30809 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 30810 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 30811 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 30812 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 30813 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 30814 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 30815 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 30816 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 30817 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 30818 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 30819 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 30820 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 30821 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 30822 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 30823 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 30824 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 30825 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 30826 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 30827 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 30828 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 30829 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 30830 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 30831 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 30832 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 30833 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 30834 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 30835 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 30836 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 30837 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 30838 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 30839 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 30840 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 30841 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 30842 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 30843 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 30844 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 30845 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 30846 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 30847 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 30848 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 30849 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 30850 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 30851 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 30852 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 30853 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 30854 - protein, 189 aa, Artificial Sequence
  Artificially synthesized modified ADAM10 peptide
NPLNKYIRHYEGLSYNVDSLHQKHQRAKAAVSHEAQFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 30855 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 30856 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 30857 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 30858 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 30859 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 30860 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 30861 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 30862 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 30863 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 30864 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 30865 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 30866 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 30867 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 30868 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 30869 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 30870 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 30871 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 30872 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 30873 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 30874 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 30875 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 30876 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 30877 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 30878 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 30879 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 30880 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 30881 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 30882 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 30883 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 30884 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 30885 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 30886 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 30887 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 30888 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 30889 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 30890 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 30891 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 30892 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 30893 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 30894 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 30895 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 30896 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 30897 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 30898 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 30899 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 30900 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 30901 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 30902 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 30903 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 30904 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 30905 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 30906 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 30907 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 30908 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 30909 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 30910 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 30911 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 30912 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 30913 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 30914 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 30915 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 30916 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 30917 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 30918 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 30919 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 30920 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 30921 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 30922 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 30923 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 30924 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 30925 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 30926 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 30927 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 30928 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 30929 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 30930 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 30931 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 30932 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 30933 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 30934 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 30935 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 30936 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 30937 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 30938 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 30939 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 30940 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 30941 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 30942 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 30943 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 30944 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 30945 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 30946 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 30947 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 30948 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 30949 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 30950 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 30951 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 30952 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 30953 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 30954 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 30955 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 30956 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 30957 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 30958 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 30959 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 30960 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 30961 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 30962 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 30963 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 30964 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 30965 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 30966 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 30967 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 30968 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 30969 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 30970 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 30971 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 30972 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 30973 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 30974 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 30975 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 30976 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 30977 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 30978 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 30979 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 30980 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 30981 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 30982 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 30983 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 30984 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 30985 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 30986 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 30987 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 30988 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 30989 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 30990 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 30991 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 30992 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 30993 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 30994 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 30995 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 30996 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 30997 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 30998 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 30999 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 31000 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 31001 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 31002 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 31003 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 31004 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 31005 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 31006 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 31007 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 31008 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 31009 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 31010 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 31011 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 31012 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 31013 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 31014 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 31015 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 31016 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 31017 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 31018 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 31019 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 31020 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 31021 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 31022 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 31023 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 31024 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 31025 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 31026 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 31027 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 31028 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 31029 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 31030 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 31031 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 31032 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 31033 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 31034 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 31035 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 31036 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 31037 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 31038 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 31039 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 31040 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 31041 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 31042 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 31043 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 31044 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 31045 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 31046 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 31047 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 31048 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 31049 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 31050 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 31051 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 31052 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 31053 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 31054 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 31055 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 31056 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 31057 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 31058 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 31059 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 31060 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 31061 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 31062 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 31063 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 31064 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 31065 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 31066 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 31067 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 31068 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 31069 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 31070 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 31071 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 31072 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 31073 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 31074 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 31075 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 31076 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 31077 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 31078 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 31079 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 31080 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 31081 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 31082 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 31083 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 31084 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 31085 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 31086 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 31087 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 31088 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 31089 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 31090 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 31091 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 31092 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 31093 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 31094 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 31095 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 31096 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 31097 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 31098 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 31099 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 31100 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 31101 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 31102 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 31103 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 31104 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 31105 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 31106 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 31107 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 31108 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 31109 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 31110 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 31111 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 31112 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 31113 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 31114 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 31115 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 31116 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 31117 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 31118 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 31119 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 31120 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 31121 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 31122 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 31123 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 31124 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 31125 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 31126 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 31127 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 31128 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 31129 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 31130 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 31131 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 31132 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 31133 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 31134 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 31135 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 31136 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 31137 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 31138 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 31139 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 31140 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 31141 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 31142 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 31143 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 31144 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 31145 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 31146 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 31147 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 31148 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 31149 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 31150 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 31151 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 31152 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 31153 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 31154 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 31155 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 31156 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 31157 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 31158 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 31159 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 31160 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 31161 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 31162 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 31163 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 31164 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 31165 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 31166 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 31167 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 31168 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 31169 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 31170 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 31171 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 31172 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 31173 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 31174 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 31175 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 31176 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 31177 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 31178 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 31179 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 31180 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 31181 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 31182 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 31183 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 31184 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 31185 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 31186 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 31187 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 31188 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 31189 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 31190 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 31191 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 31192 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 31193 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 31194 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 31195 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 31196 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 31197 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 31198 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 31199 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 31200 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 31201 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 31202 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 31203 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 31204 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 31205 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 31206 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 31207 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 31208 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 31209 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 31210 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 31211 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 31212 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 31213 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 31214 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 31215 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 31216 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 31217 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 31218 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 31219 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 31220 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 31221 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 31222 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 31223 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 31224 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 31225 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 31226 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 31227 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 31228 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 31229 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 31230 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 31231 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 31232 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 31233 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 31234 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 31235 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 31236 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 31237 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 31238 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 31239 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 31240 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 31241 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 31242 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 31243 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 31244 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 31245 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 31246 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 31247 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 31248 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 31249 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 31250 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 31251 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 31252 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 31253 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 31254 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 31255 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 31256 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 31257 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 31258 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 31259 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 31260 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 31261 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 31262 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 31263 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 31264 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 31265 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 31266 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 31267 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 31268 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 31269 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 31270 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 31271 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 31272 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 31273 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 31274 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 31275 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 31276 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 31277 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 31278 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 31279 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 31280 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 31281 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 31282 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 31283 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 31284 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 31285 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 31286 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 31287 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 31288 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 31289 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 31290 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 31291 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 31292 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 31293 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 31294 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 31295 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 31296 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 31297 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 31298 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 31299 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 31300 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 31301 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 31302 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 31303 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 31304 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 31305 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 31306 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 31307 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 31308 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 31309 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 31310 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 31311 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 31312 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 31313 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 31314 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 31315 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 31316 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 31317 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 31318 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 31319 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 31320 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 31321 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 31322 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 31323 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 31324 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 31325 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 31326 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 31327 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 31328 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 31329 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 31330 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 31331 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 31332 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 31333 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 31334 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 31335 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 31336 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 31337 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 31338 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 31339 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 31340 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 31341 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 31342 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 31343 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 31344 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 31345 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 31346 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 31347 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 31348 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 31349 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 31350 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 31351 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 31352 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 31353 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 31354 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 31355 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 31356 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 31357 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 31358 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 31359 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 31360 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 31361 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 31362 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 31363 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 31364 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 31365 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 31366 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 31367 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 31368 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 31369 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 31370 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 31371 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 31372 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 31373 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 31374 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 31375 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 31376 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 31377 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 31378 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 31379 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 31380 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 31381 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 31382 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 31383 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 31384 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 31385 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 31386 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 31387 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 31388 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 31389 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 31390 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 31391 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 31392 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 31393 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 31394 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 31395 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 31396 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 31397 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 31398 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 31399 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 31400 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 31401 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 31402 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 31403 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 31404 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 31405 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 31406 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 31407 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 31408 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 31409 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 31410 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 31411 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 31412 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 31413 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 31414 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 31415 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 31416 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 31417 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 31418 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 31419 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 31420 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 31421 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 31422 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 31423 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 31424 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 31425 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 31426 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 31427 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 31428 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 31429 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 31430 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 31431 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 31432 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 31433 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 31434 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 31435 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 31436 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 31437 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 31438 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 31439 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 31440 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 31441 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 31442 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 31443 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 31444 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 31445 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 31446 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 31447 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 31448 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 31449 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 31450 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 31451 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 31452 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 31453 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 31454 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 31455 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 31456 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 31457 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 31458 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 31459 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 31460 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 31461 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 31462 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 31463 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 31464 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 31465 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 31466 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 31467 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 31468 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 31469 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 31470 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 31471 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 31472 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 31473 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 31474 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 31475 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 31476 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 31477 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 31478 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 31479 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 31480 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 31481 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 31482 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 31483 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 31484 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 31485 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 31486 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 31487 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 31488 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 31489 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 31490 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 31491 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 31492 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 31493 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 31494 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 31495 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 31496 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 31497 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 31498 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 31499 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 31500 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 31501 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 31502 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 31503 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 31504 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 31505 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 31506 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 31507 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 31508 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 31509 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 31510 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 31511 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 31512 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 31513 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 31514 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 31515 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 31516 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 31517 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 31518 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 31519 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 31520 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 31521 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 31522 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 31523 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 31524 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 31525 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 31526 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 31527 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 31528 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 31529 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 31530 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 31531 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 31532 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 31533 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 31534 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 31535 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 31536 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 31537 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 31538 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 31539 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 31540 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 31541 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 31542 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 31543 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 31544 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 31545 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 31546 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 31547 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 31548 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 31549 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 31550 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 31551 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 31552 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 31553 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 31554 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 31555 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 31556 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 31557 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 31558 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 31559 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 31560 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 31561 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 31562 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 31563 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 31564 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 31565 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 31566 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 31567 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 31568 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 31569 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 31570 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 31571 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 31572 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 31573 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 31574 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 31575 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 31576 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 31577 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 31578 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 31579 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 31580 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 31581 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 31582 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 31583 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 31584 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 31585 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 31586 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 31587 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 31588 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 31589 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 31590 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 31591 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 31592 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 31593 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 31594 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 31595 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 31596 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 31597 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 31598 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 31599 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 31600 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 31601 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 31602 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 31603 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 31604 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 31605 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 31606 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 31607 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 31608 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 31609 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 31610 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 31611 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 31612 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 31613 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 31614 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 31615 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 31616 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 31617 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 31618 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 31619 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 31620 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 31621 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 31622 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 31623 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 31624 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 31625 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 31626 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 31627 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 31628 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 31629 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 31630 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 31631 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 31632 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 31633 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 31634 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 31635 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 31636 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 31637 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 31638 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 31639 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 31640 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 31641 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 31642 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 31643 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 31644 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 31645 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 31646 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 31647 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 31648 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 31649 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 31650 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 31651 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 31652 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 31653 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 31654 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 31655 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 31656 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 31657 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 31658 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 31659 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 31660 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 31661 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 31662 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 31663 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 31664 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 31665 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 31666 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 31667 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 31668 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 31669 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 31670 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 31671 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 31672 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 31673 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 31674 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 31675 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 31676 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 31677 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 31678 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 31679 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 31680 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 31681 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 31682 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 31683 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 31684 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 31685 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 31686 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 31687 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 31688 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 31689 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 31690 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 31691 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 31692 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 31693 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 31694 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 31695 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 31696 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 31697 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 31698 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 31699 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 31700 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 31701 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 31702 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 31703 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 31704 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 31705 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 31706 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 31707 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 31708 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 31709 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 31710 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 31711 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 31712 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 31713 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 31714 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 31715 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 31716 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 31717 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 31718 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 31719 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 31720 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 31721 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 31722 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 31723 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 31724 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 31725 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 31726 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 31727 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 31728 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 31729 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 31730 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 31731 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 31732 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 31733 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 31734 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 31735 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 31736 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 31737 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 31738 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 31739 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 31740 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 31741 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 31742 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 31743 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 31744 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 31745 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 31746 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 31747 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 31748 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 31749 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 31750 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 31751 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 31752 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 31753 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 31754 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 31755 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 31756 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 31757 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 31758 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 31759 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 31760 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 31761 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 31762 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 31763 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 31764 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 31765 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 31766 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 31767 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 31768 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 31769 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 31770 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 31771 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 31772 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 31773 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 31774 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 31775 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 31776 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 31777 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 31778 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 31779 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 31780 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 31781 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 31782 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 31783 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 31784 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 31785 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 31786 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 31787 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 31788 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 31789 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 31790 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 31791 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 31792 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 31793 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 31794 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 31795 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 31796 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 31797 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 31798 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 31799 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 31800 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 31801 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 31802 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 31803 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 31804 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 31805 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 31806 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 31807 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 31808 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 31809 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 31810 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 31811 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 31812 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 31813 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 31814 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 31815 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 31816 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 31817 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 31818 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 31819 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 31820 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 31821 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 31822 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 31823 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 31824 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 31825 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 31826 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 31827 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 31828 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 31829 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 31830 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 31831 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 31832 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 31833 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 31834 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 31835 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 31836 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 31837 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 31838 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 31839 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 31840 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 31841 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 31842 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 31843 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 31844 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 31845 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 31846 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 31847 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 31848 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 31849 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 31850 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 31851 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 31852 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 31853 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 31854 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 31855 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 31856 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 31857 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 31858 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 31859 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 31860 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 31861 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 31862 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 31863 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 31864 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 31865 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 31866 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 31867 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 31868 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 31869 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 31870 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 31871 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 31872 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 31873 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 31874 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 31875 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 31876 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 31877 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 31878 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 31879 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 31880 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 31881 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 31882 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 31883 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 31884 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 31885 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 31886 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 31887 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 31888 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 31889 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 31890 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 31891 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 31892 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 31893 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 31894 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 31895 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 31896 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 31897 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 31898 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 31899 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 31900 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 31901 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 31902 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 31903 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 31904 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 31905 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 31906 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 31907 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 31908 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 31909 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 31910 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 31911 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 31912 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 31913 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 31914 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 31915 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 31916 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 31917 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 31918 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 31919 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 31920 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 31921 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 31922 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 31923 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 31924 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 31925 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 31926 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 31927 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 31928 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 31929 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 31930 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 31931 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 31932 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 31933 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 31934 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 31935 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 31936 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 31937 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 31938 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 31939 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 31940 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 31941 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 31942 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 31943 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 31944 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 31945 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 31946 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 31947 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 31948 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 31949 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 31950 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 31951 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 31952 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 31953 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 31954 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 31955 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 31956 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 31957 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 31958 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 31959 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 31960 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 31961 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 31962 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 31963 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 31964 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 31965 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 31966 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 31967 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 31968 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 31969 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 31970 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 31971 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 31972 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 31973 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 31974 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 31975 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 31976 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 31977 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 31978 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 31979 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 31980 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 31981 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 31982 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 31983 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 31984 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 31985 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 31986 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 31987 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 31988 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 31989 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 31990 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 31991 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 31992 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 31993 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 31994 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 31995 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 31996 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 31997 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 31998 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 31999 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 32000 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 32001 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 32002 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 32003 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 32004 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 32005 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 32006 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 32007 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 32008 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 32009 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 32010 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 32011 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 32012 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 32013 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 32014 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 32015 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 32016 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 32017 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 32018 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 32019 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 32020 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 32021 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 32022 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 32023 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 32024 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 32025 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 32026 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 32027 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 32028 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 32029 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 32030 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 32031 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 32032 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 32033 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 32034 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 32035 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 32036 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 32037 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 32038 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 32039 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 32040 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 32041 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 32042 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 32043 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 32044 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 32045 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 32046 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 32047 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 32048 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 32049 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 32050 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 32051 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 32052 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 32053 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 32054 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 32055 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 32056 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 32057 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 32058 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 32059 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 32060 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 32061 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 32062 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 32063 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 32064 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 32065 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 32066 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 32067 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 32068 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 32069 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 32070 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 32071 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 32072 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 32073 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 32074 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 32075 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 32076 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 32077 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 32078 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 32079 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 32080 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 32081 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 32082 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 32083 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 32084 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 32085 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 32086 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 32087 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 32088 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 32089 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 32090 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 32091 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 32092 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 32093 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 32094 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 32095 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 32096 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 32097 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 32098 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 32099 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 32100 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 32101 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 32102 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 32103 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 32104 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 32105 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 32106 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 32107 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 32108 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 32109 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 32110 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 32111 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 32112 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 32113 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 32114 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 32115 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 32116 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 32117 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 32118 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 32119 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 32120 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 32121 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 32122 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 32123 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 32124 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 32125 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 32126 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 32127 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 32128 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 32129 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 32130 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 32131 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 32132 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 32133 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 32134 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 32135 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 32136 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 32137 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 32138 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 32139 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 32140 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 32141 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 32142 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 32143 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 32144 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 32145 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 32146 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 32147 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 32148 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 32149 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 32150 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 32151 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 32152 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 32153 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 32154 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 32155 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 32156 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 32157 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 32158 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 32159 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 32160 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 32161 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 32162 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 32163 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 32164 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 32165 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 32166 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 32167 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 32168 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 32169 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 32170 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 32171 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 32172 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 32173 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 32174 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 32175 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 32176 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 32177 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 32178 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 32179 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 32180 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 32181 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 32182 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 32183 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 32184 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 32185 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 32186 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 32187 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 32188 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 32189 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 32190 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 32191 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 32192 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 32193 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 32194 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 32195 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 32196 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 32197 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 32198 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 32199 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 32200 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 32201 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 32202 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 32203 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 32204 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 32205 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 32206 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 32207 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 32208 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 32209 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 32210 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 32211 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 32212 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 32213 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 32214 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 32215 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 32216 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 32217 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 32218 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 32219 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 32220 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 32221 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 32222 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 32223 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 32224 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 32225 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 32226 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 32227 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 32228 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 32229 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 32230 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 32231 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 32232 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 32233 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 32234 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 32235 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 32236 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 32237 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 32238 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 32239 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 32240 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 32241 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 32242 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 32243 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 32244 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 32245 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 32246 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 32247 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 32248 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 32249 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 32250 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 32251 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 32252 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 32253 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 32254 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 32255 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 32256 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 32257 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 32258 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 32259 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 32260 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 32261 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 32262 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 32263 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 32264 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 32265 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 32266 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 32267 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 32268 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 32269 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 32270 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 32271 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 32272 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 32273 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 32274 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 32275 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 32276 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 32277 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 32278 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 32279 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 32280 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 32281 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 32282 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 32283 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 32284 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 32285 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 32286 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 32287 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 32288 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 32289 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 32290 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 32291 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 32292 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 32293 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 32294 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 32295 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 32296 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 32297 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 32298 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 32299 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 32300 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 32301 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 32302 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 32303 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 32304 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 32305 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 32306 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 32307 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 32308 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 32309 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 32310 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 32311 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 32312 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 32313 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 32314 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 32315 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 32316 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 32317 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 32318 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 32319 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 32320 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 32321 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 32322 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 32323 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 32324 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 32325 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 32326 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 32327 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 32328 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 32329 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 32330 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 32331 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 32332 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 32333 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 32334 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 32335 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 32336 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 32337 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 32338 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 32339 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 32340 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 32341 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 32342 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 32343 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 32344 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 32345 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 32346 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 32347 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 32348 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 32349 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 32350 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 32351 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 32352 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 32353 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 32354 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 32355 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 32356 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 32357 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 32358 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 32359 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 32360 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 32361 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 32362 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 32363 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 32364 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 32365 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 32366 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 32367 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 32368 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 32369 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 32370 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 32371 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 32372 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 32373 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 32374 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 32375 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 32376 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 32377 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 32378 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 32379 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 32380 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 32381 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 32382 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 32383 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 32384 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 32385 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 32386 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 32387 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 32388 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 32389 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 32390 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 32391 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 32392 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 32393 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 32394 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 32395 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 32396 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 32397 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 32398 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 32399 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 32400 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 32401 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 32402 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 32403 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 32404 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 32405 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 32406 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 32407 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 32408 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 32409 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 32410 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 32411 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 32412 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 32413 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 32414 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 32415 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 32416 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 32417 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 32418 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 32419 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 32420 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 32421 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 32422 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 32423 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 32424 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 32425 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 32426 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 32427 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 32428 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 32429 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 32430 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 32431 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 32432 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 32433 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 32434 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 32435 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 32436 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 32437 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 32438 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 32439 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 32440 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 32441 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 32442 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 32443 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 32444 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 32445 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 32446 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 32447 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 32448 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 32449 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 32450 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 32451 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 32452 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 32453 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 32454 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 32455 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 32456 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 32457 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 32458 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 32459 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 32460 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 32461 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 32462 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 32463 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 32464 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 32465 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 32466 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 32467 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 32468 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 32469 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 32470 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 32471 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 32472 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 32473 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 32474 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 32475 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 32476 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 32477 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 32478 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 32479 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 32480 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 32481 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 32482 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 32483 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 32484 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 32485 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 32486 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 32487 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 32488 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 32489 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 32490 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 32491 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 32492 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 32493 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 32494 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 32495 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 32496 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 32497 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 32498 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 32499 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 32500 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 32501 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 32502 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 32503 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 32504 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 32505 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 32506 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 32507 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 32508 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 32509 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 32510 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 32511 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 32512 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 32513 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 32514 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 32515 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 32516 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 32517 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 32518 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 32519 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 32520 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 32521 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 32522 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 32523 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 32524 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 32525 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 32526 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 32527 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 32528 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 32529 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 32530 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 32531 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 32532 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 32533 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 32534 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 32535 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 32536 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 32537 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 32538 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 32539 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 32540 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 32541 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 32542 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 32543 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 32544 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 32545 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 32546 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 32547 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 32548 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 32549 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 32550 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 32551 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 32552 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 32553 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 32554 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 32555 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 32556 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 32557 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 32558 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 32559 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 32560 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 32561 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 32562 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 32563 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 32564 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 32565 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 32566 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 32567 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 32568 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 32569 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 32570 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 32571 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 32572 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 32573 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 32574 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 32575 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 32576 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK
